United States Patent 7,745,391 (HUMAN THROMBOSPONDIN POLYPEPTIDE) - sequence listing, part 258

SEQ ID NO: 735292 - DNA, 188548 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735293 - DNA, 188505 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735294 - DNA, 188384 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735295 - DNA, 188427 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735296 - DNA, 188529 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735297 - DNA, 188421 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735298 - DNA, 188378 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735299 - DNA, 188257 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735300 - DNA, 188300 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735301 - DNA, 188402 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735302 - DNA, 188086 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735303 - DNA, 187923 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735304 - DNA, 187827 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735305 - DNA, 188385 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735306 - DNA, 188342 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735307 - DNA, 188221 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg
